United States Patent 12,569,549 (FLAVIVIRUS VACCINE) - sequence listing, part 45

SEQ ID NO: 16551 - RNA, 9879 nt, synthetic construct
  misc_feature 1..9879: note = derived and/or modified CDS sequence (opt4) from DENV-1__GU131741__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgtgagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16552 - RNA, 9879 nt, synthetic construct
  misc_feature 1..9879: note = derived and/or modified CDS sequence (opt4) from DENV-1__GU131743__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacgtgatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16553 - RNA, 9879 nt, synthetic construct
  misc_feature 1..9879: note = derived and/or modified CDS sequence (opt4) from DENV-1__JN093516__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagcacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccaccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggagtgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16554 - RNA, 9879 nt, synthetic construct
  misc_feature 1..9879: note = derived and/or modified CDS sequence (opt4) from DENV-1__GU131746__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagaaggcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16555 - RNA, 9879 nt, synthetic construct
  misc_feature 1..9879: note = derived and/or modified CDS sequence (opt4) from DENV-1__JF937609__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16556 - RNA, 9879 nt, synthetic construct
  misc_feature 1..9879: note = derived and/or modified CDS sequence (opt4) from DENV-1__KF921949__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcagaaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgaccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccaagaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16557 - RNA, 9879 nt, synthetic construct
  misc_feature 1..9879: note = derived and/or modified CDS sequence (opt4) from DENV-1__GU131747__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgccggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcagagccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgttcctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccgtgctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16558 - RNA, 9879 nt, synthetic construct
  misc_feature 1..9879: note = derived and/or modified CDS sequence (opt4) from DENV-1__GU131748__SS-prME
  source 1..9879: mol_type = other RNA
agcgtgaccatgctgttcatgctggtgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtgaagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16559 - RNA, 9879 nt, synthetic construct
  misc_feature 1..9879: note = derived and/or modified CDS sequence (opt4) from DENV-1__GQ868615__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16560 - RNA, 9879 nt, synthetic construct
  misc_feature 1..9879: note = derived and/or modified CDS sequence (opt4) from DENV-1__GU131749__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacagagtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccatcaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16561 - RNA, 9879 nt, synthetic construct
  misc_feature 1..9879: note = derived and/or modified CDS sequence (opt4) from DENV-1__GU131750__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcatcgagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgatgcagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacaccatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16562 - RNA, 9879 nt, synthetic construct
  misc_feature 1..9879: note = derived and/or modified CDS sequence (opt4) from DENV-1__GU131751__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaaggtgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcagagacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcaagtggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacatccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccaccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16563 - RNA, 9879 nt, synthetic construct
  misc_feature 1..9879: note = derived and/or modified CDS sequence (opt4) from DENV-1__GU131753__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcatcaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagatgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatgaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgaccgccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgtgcagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgaagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgttcgactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16564 - RNA, 9879 nt, synthetic construct
  misc_feature 1..9879: note = derived and/or modified CDS sequence (opt4) from DENV-1__GU131754__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggacaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtggtgaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcatgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16565 - RNA, 9879 nt, synthetic construct
  misc_feature 1..9879: note = derived and/or modified CDS sequence (opt4) from DENV-1__GU131755__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatcagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactgcgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacaagcagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16566 - RNA, 9879 nt, synthetic construct
  misc_feature 1..9879: note = derived and/or modified CDS sequence (opt4) from DENV-1__GU131756__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgccttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16567 - RNA, 9879 nt, synthetic construct
  misc_feature 1..9879: note = derived and/or modified CDS sequence (opt4) from DENV-1__GU131758__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgtgccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcttcaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaaggtgtggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16568 - RNA, 9879 nt, synthetic construct
  misc_feature 1..9879: note = derived and/or modified CDS sequence (opt4) from DENV-1__GU131759__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcttcaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaaggtgtggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagccacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16569 - RNA, 9879 nt, synthetic construct
  misc_feature 1..9879: note = derived and/or modified CDS sequence (opt4) from DENV-1__GU131761__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatccaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16570 - RNA, 9879 nt, synthetic construct
  misc_feature 1..9879: note = derived and/or modified CDS sequence (opt4) from DENV-1__GU131762__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcatgagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcctgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagagtgtacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16571 - RNA, 9879 nt, synthetic construct
  misc_feature 1..9879: note = derived and/or modified CDS sequence (opt4) from DENV-1__GU131763__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcctgggcgaggtggacagcttcagcctgggcctgctgtgcatcagcatcatgatcgaggaggtgatgagaagcagatggagcagaaagatgctgatggccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagagatgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacaaggtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16572 - RNA, 9879 nt, synthetic construct
  misc_feature 1..9879: note = derived and/or modified CDS sequence (opt4) from DENV-1__GU131766__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcatcgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgatcgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagatgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgcgccaccctgctgagcctgaccttcatcaagaccaccctgagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgtgcagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgaagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16573 - RNA, 9879 nt, synthetic construct
  misc_feature 1..9879: note = derived and/or modified CDS sequence (opt4) from DENV-1__GU131767__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgagagccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16574 - RNA, 9879 nt, synthetic construct
  misc_feature 1..9879: note = derived and/or modified CDS sequence (opt4) from DENV-1__HM181967__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacatggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16575 - RNA, 9879 nt, synthetic construct
  misc_feature 1..9879: note = derived and/or modified CDS sequence (opt4) from DENV-1__GU131768__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcaactggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgaagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgccgacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16576 - RNA, 9879 nt, synthetic construct
  misc_feature 1..9879: note = derived and/or modified CDS sequence (opt4) from DENV-1__GU131770__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatcagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactgcgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacaagcagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16577 - RNA, 9879 nt, synthetic construct
  misc_feature 1..9879: note = derived and/or modified CDS sequence (opt4) from DENV-1__GU131773__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcatgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcctgctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16578 - RNA, 9879 nt, synthetic construct
  misc_feature 1..9879: note = derived and/or modified CDS sequence (opt4) from DENV-1__GU131775__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtggtggtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcggcaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16579 - RNA, 9879 nt, synthetic construct
  misc_feature 1..9879: note = derived and/or modified CDS sequence (opt4) from DENV-1__GU131777__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16580 - RNA, 9879 nt, synthetic construct
  misc_feature 1..9879: note = derived and/or modified CDS sequence (opt4) from DENV-1__GU131778__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacatccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcagaatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16581 - RNA, 9879 nt, synthetic construct
  misc_feature 1..9879: note = derived and/or modified CDS sequence (opt4) from DENV-1__GU131779__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggtgagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16582 - RNA, 9879 nt, synthetic construct
  misc_feature 1..9879: note = derived and/or modified CDS sequence (opt4) from DENV-1__GU131780__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcagcggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctgaccgtgagcggcgtgtaccccctgagcatccccgccaccctgttcgtgtggtacttctggcagaagaagaagcagagaagcggcgtgctgtgggacacccccagcccccccaaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccatgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccagaagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16583 - RNA, 9879 nt, synthetic construct
  misc_feature 1..9879: note = derived and/or modified CDS sequence (opt4) from DENV-1__GU131781__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggacaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtggtgaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcatgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16584 - RNA, 9879 nt, synthetic construct
  misc_feature 1..9879: note = derived and/or modified CDS sequence (opt4) from DENV-1__GU131782__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcctgggcgaggtggacagcttcagcctgggcctgctgtgcatcagcatcatgatcgaggaggtgatgagaagcagatggagcagaaagatgctgatggccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagccccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagagatgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16585 - RNA, 9879 nt, synthetic construct
  misc_feature 1..9879: note = derived and/or modified CDS sequence (opt4) from DENV-1__GU131784__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcaccacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccagaagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16586 - RNA, 9879 nt, synthetic construct
  misc_feature 1..9879: note = derived and/or modified CDS sequence (opt4) from DENV-1__JF937612__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcagagacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16587 - RNA, 9879 nt, synthetic construct
  misc_feature 1..9879: note = derived and/or modified CDS sequence (opt4) from DENV-1__GU131786__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggcccccgccagaggcgccagaagaatggccatcctgggcgccaccgcctgggacttcggcagcatcggcggcgtgttccccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgagagccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16588 - RNA, 9879 nt, synthetic construct
  misc_feature 1..9879: note = derived and/or modified CDS sequence (opt4) from DENV-1__GU131787__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16589 - RNA, 9879 nt, synthetic construct
  misc_feature 1..9879: note = derived and/or modified CDS sequence (opt4) from DENV-1__HM181968__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgccacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcgccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgctgagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccatcgactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16590 - RNA, 9879 nt, synthetic construct
  misc_feature 1..9879: note = derived and/or modified CDS sequence (opt4) from DENV-1__GU131789__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccatcctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16591 - RNA, 9879 nt, synthetic construct
  misc_feature 1..9879: note = derived and/or modified CDS sequence (opt4) from DENV-1__GU131790__SS-prME
  source 1..9879: mol_type = other RNA
agcgtgaccatgctgctgatgctggtgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagctgatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtgaagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16592 - RNA, 9879 nt, synthetic construct
  misc_feature 1..9879: note = derived and/or modified CDS sequence (opt4) from DENV-1__GU131791__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggccccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatcctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16593 - RNA, 9879 nt, synthetic construct
  misc_feature 1..9879: note = derived and/or modified CDS sequence (opt4) from DENV-1__GU131792__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagccctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagccttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaccttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgcccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccggcctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcggcaccaacgaggtgcacacctggaccgagcagtacaagttccaggccgacagccccaagagactgagcgccgccatcggcaagccctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatggccgccgccatcaaggacagaaaggccgtgcacgccgacatgggctactggatcgagagcgagaagaacgagccctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctggccagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16594 - RNA, 9879 nt, synthetic construct
  misc_feature 1..9879: note = derived and/or modified CDS sequence (opt4) from DENV-1__HM488256__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgcccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgcccccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctgggccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagccccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgccctggaacgacctgatcagactgtgcatcatggtgggcgccaccgccagcgccagaatgggcatgggcaccaccagcctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatgggcctgagcgtggtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16595 - RNA, 9879 nt, synthetic construct
  misc_feature 1..9879: note = derived and/or modified CDS sequence (opt4) from DENV-1__GU131793__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcaccacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactgcgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacaagcagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16596 - RNA, 9879 nt, synthetic construct
  misc_feature 1..9879: note = derived and/or modified CDS sequence (opt4) from DENV-1__GU131794__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcatcagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16597 - RNA, 9879 nt, synthetic construct
  misc_feature 1..9879: note = derived and/or modified CDS sequence (opt4) from DENV-1__GU131796__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccgaccccgccgtgctgagaaagctgtgcgtggaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccagcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccgccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16598 - RNA, 9879 nt, synthetic construct
  misc_feature 1..9879: note = derived and/or modified CDS sequence (opt4) from DENV-1__GU131797__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactgcgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacaagcagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16599 - RNA, 9879 nt, synthetic construct
  misc_feature 1..9879: note = derived and/or modified CDS sequence (opt4) from DENV-1__GU131801__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcggcatcggcgccggcgagaaggccctgaagctgagctgggtgaagaagggcagcagcatcggcaagatggtggaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16600 - RNA, 9879 nt, synthetic construct
  misc_feature 1..9879: note = derived and/or modified CDS sequence (opt4) from DENV-1__GU131804__SS-prME
  source 1..9879: mol_type = other RNA
agcgtgaccatgttcctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccagagccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacatcgacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16601 - RNA, 9879 nt, synthetic construct
  misc_feature 1..9879: note = derived and/or modified CDS sequence (opt4) from DENV-1__GU131805__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccgaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagccccgagatccagctgcccgactacggcgccctgaccctggactgcagccccagacccggcctggacttcaacgagatggtgctgctgcccatgaaggagaagagctggctggtgcacaagcagtggttcctggacctgcccctgccctggaccagcggcgccagcaccagccaggagacctggaacagaaaggacctgctgggcaccttcaagaccgcccacgccaaggagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagcccgccttcggcgagagctacatcgtgatcggcgccggcgagaaggccctgaagctgagctgggtgaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcggcaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgccatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagccctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgcccggcaagatcatccacgagtggtgctgcagaagctgcaccctgccccccctgagattcaagggcgaggacggctgctggtacggcatggagatcagccccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggccccctgcccgtgttcttcctgctgatcatgggccagctgccctggaacgacctgatcagactgtgcatcatggtgggcgccaacgccagcgacagaatgggcatgggcaccccctacctggccctgatggccaccttcaagatgagacccatgttcgccgtgggcctgctgttcagaagactgaccagcagagagggcctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctggccctgaccttcatcaagaccaccttcagcctggactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcggcagccacaacatcctggtggaggtgcaggacgacggcaccatgaagatcaaggacgaggagagagacgccaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccgccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16602 - RNA, 9879 nt, synthetic construct
  misc_feature 1..9879: note = derived and/or modified CDS sequence (opt4) from DENV-1__GU131806__SS-prME
  source 1..9879: mol_type = other RNA
agcgtgaccatgttcctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctggcctggaccagcggcggcagcaccagccaggagacctggaacagacaggacctggtggtgaccttcaagaccgcccacggcaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctggccaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggccccagccacaacatcctggtggaggtgcaggacgacggccccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcctgggcctgtacggcaacggcgtggtgaccaccagcggcacctacgtgagcgccatcgcccaggccagagccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16603 - RNA, 9879 nt, synthetic construct
  misc_feature 1..9879: note = derived and/or modified CDS sequence (opt4) from DENV-1__GU131807__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagcccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctggtgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggccccgcctacggcgtgctgttcagcggcgtgagctggcccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgaccactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatcagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactgcgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagaagaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacaagcagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16604 - RNA, 9879 nt, synthetic construct
  misc_feature 1..9879: note = derived and/or modified CDS sequence (opt4) from DENV-1__GU131811__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagatcggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgagaccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcatgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaaggtggtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16605 - RNA, 9882 nt, synthetic construct
  misc_feature 1..9882: note = derived and/or modified CDS sequence (opt4) from DENV-1__JF937615__SS-prME
  source 1..9882: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccgaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccgacagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgatcgacttccagagccaccagctgtgggccaccctgctgagcctgaccttcatcaagaccaccttcagcctgcactacgcctggaagaccatggccatggtgctgagcatcgtgagcctgttccccctgctgcccgtgcacgacctgcccaagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcgccctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgttcctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccgccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16606 - RNA, 9879 nt, synthetic construct
  misc_feature 1..9879: note = derived and/or modified CDS sequence (opt4) from DENV-1__GU131814__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacgagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16607 - RNA, 9879 nt, synthetic construct
  misc_feature 1..9879: note = derived and/or modified CDS sequence (opt4) from DENV-1__GU131815__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccagactggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcaccatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgccagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcgtggccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16608 - RNA, 9879 nt, synthetic construct
  misc_feature 1..9879: note = derived and/or modified CDS sequence (opt4) from DENV-1__GU131818__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagcacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctggtgctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccagcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgaaggagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16609 - RNA, 9879 nt, synthetic construct
  misc_feature 1..9879: note = derived and/or modified CDS sequence (opt4) from DENV-1__GU131820__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcctgggcgaggtggacagcttcagcctgggcctgctgtgcatcagcatcatgatcgaggaggtgatgagaagcagatggagcagaaagatgctgatggccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagagatgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16610 - RNA, 9879 nt, synthetic construct
  misc_feature 1..9879: note = derived and/or modified CDS sequence (opt4) from DENV-1__HM181970__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccttcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggaggacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggccacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16611 - RNA, 9879 nt, synthetic construct
  misc_feature 1..9879: note = derived and/or modified CDS sequence (opt4) from DENV-1__GU131821__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagcacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggagtgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16612 - RNA, 9879 nt, synthetic construct
  misc_feature 1..9879: note = derived and/or modified CDS sequence (opt4) from DENV-1__JF937617__SS-prME
  source 1..9879: mol_type = other RNA
agcgtgaccatgctgctgatgctgatgcccaccgccctggccttccacctgaccaccagaggcggcgagccccacatggtggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcctgggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacgtgatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatgggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgagatcggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16613 - RNA, 9879 nt, synthetic construct
  misc_feature 1..9879: note = derived and/or modified CDS sequence (opt4) from DENV-1__JF937618__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccagaaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggaccgccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16614 - RNA, 9879 nt, synthetic construct
  misc_feature 1..9879: note = derived and/or modified CDS sequence (opt4) from DENV-1__JF937619__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggtgaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaagaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtgatctacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16615 - RNA, 9879 nt, synthetic construct
  misc_feature 1..9879: note = derived and/or modified CDS sequence (opt4) from DENV-1__GU131827__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcagaaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgccatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcgtgcccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16616 - RNA, 9879 nt, synthetic construct
  misc_feature 1..9879: note = derived and/or modified CDS sequence (opt4) from DENV-1__GU131831__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16617 - RNA, 9879 nt, synthetic construct
  misc_feature 1..9879: note = derived and/or modified CDS sequence (opt4) from DENV-1__EU482789__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagatggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcagaggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16618 - RNA, 9879 nt, synthetic construct
  misc_feature 1..9879: note = derived and/or modified CDS sequence (opt4) from DENV-1__EU482790__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcagcagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgtgccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtgcccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16619 - RNA, 9879 nt, synthetic construct
  misc_feature 1..9879: note = derived and/or modified CDS sequence (opt4) from DENV-1__EU482791__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16620 - RNA, 9879 nt, synthetic construct
  misc_feature 1..9879: note = derived and/or modified CDS sequence (opt4) from DENV-1__EU482792__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16621 - RNA, 9879 nt, synthetic construct
  misc_feature 1..9879: note = derived and/or modified CDS sequence (opt4) from DENV-1__EU482707__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16622 - RNA, 9879 nt, synthetic construct
  misc_feature 1..9879: note = derived and/or modified CDS sequence (opt4) from DENV-1__EU482708__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcagcgagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16623 - RNA, 9879 nt, synthetic construct
  misc_feature 1..9879: note = derived and/or modified CDS sequence (opt4) from DENV-1__EU482709__SS-prME
  source 1..9879: mol_type = other RNA
agcgtgaccatgctgctgatgctggtgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16624 - RNA, 9879 nt, synthetic construct
  misc_feature 1..9879: note = derived and/or modified CDS sequence (opt4) from DENV-1__EU482710__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagcacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaaccacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcagcgagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcatcgccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16625 - RNA, 9879 nt, synthetic construct
  misc_feature 1..9879: note = derived and/or modified CDS sequence (opt4) from DENV-1__EU482712__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagaactacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgctgttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16626 - RNA, 9879 nt, synthetic construct
  misc_feature 1..9879: note = derived and/or modified CDS sequence (opt4) from DENV-1__EU249490__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaagaaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16627 - RNA, 9879 nt, synthetic construct
  misc_feature 1..9879: note = derived and/or modified CDS sequence (opt4) from DENV-1__EU249491__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgccatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16628 - RNA, 9879 nt, synthetic construct
  misc_feature 1..9879: note = derived and/or modified CDS sequence (opt4) from DENV-1__EU249492__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcatgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgcagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcagcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggacacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcggccccgagggcgccctgtggtga

SEQ ID NO: 16629 - RNA, 9879 nt, synthetic construct
  misc_feature 1..9879: note = derived and/or modified CDS sequence (opt4) from DENV-1__EU249493__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagacaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16630 - RNA, 9879 nt, synthetic construct
  misc_feature 1..9879: note = derived and/or modified CDS sequence (opt4) from DENV-1__EU249494__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgccatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactgcatgaccagcatgaagagattcaagaacgagggcgaccccgagggcgccctgtggtga

SEQ ID NO: 16631 - RNA, 9879 nt, synthetic construct
  misc_feature 1..9879: note = derived and/or modified CDS sequence (opt4) from DENV-1__EU249495__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccaccgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16632 - RNA, 9879 nt, synthetic construct
  misc_feature 1..9879: note = derived and/or modified CDS sequence (opt4) from DENV-1__EU482794__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgccagcctgttccccctgtgcctgagcaccaccagccagaagaccacctggctgcccgtgctgctgggcagcctgggctgcaagcccctgaccatgttcctgatcaccgagaccaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggtggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaactacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16633 - RNA, 9879 nt, synthetic construct
  misc_feature 1..9879: note = derived and/or modified CDS sequence (opt4) from DENV-1__EU482795__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcagcggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaagaaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16634 - RNA, 9879 nt, synthetic construct
  misc_feature 1..9879: note = derived and/or modified CDS sequence (opt4) from DENV-1__EU482796__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagatgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgtgcagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgaagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16635 - RNA, 9879 nt, synthetic construct
  misc_feature 1..9879: note = derived and/or modified CDS sequence (opt4) from DENV-1__EU482797__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16636 - RNA, 9879 nt, synthetic construct
  misc_feature 1..9879: note = derived and/or modified CDS sequence (opt4) from DENV-1__EU482799__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgtgatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaagaccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgagatccacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16637 - RNA, 9879 nt, synthetic construct
  misc_feature 1..9879: note = derived and/or modified CDS sequence (opt4) from DENV-1__EU482800__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggccagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccatcgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgtgaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggtgcacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgttcgactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16638 - RNA, 9879 nt, synthetic construct
  misc_feature 1..9879: note = derived and/or modified CDS sequence (opt4) from DENV-1__EU482801__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16639 - RNA, 9879 nt, synthetic construct
  misc_feature 1..9879: note = derived and/or modified CDS sequence (opt4) from DENV-1__EU482802__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaagaaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaagagcaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16640 - RNA, 9879 nt, synthetic construct
  misc_feature 1..9879: note = derived and/or modified CDS sequence (opt4) from DENV-1__EU482804__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaaggtggtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcaccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcaccggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16641 - RNA, 9879 nt, synthetic construct
  misc_feature 1..9879: note = derived and/or modified CDS sequence (opt4) from DENV-1__EU482806__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagcccctgcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16642 - RNA, 9879 nt, synthetic construct
  misc_feature 1..9879: note = derived and/or modified CDS sequence (opt4) from DENV-1__EU482807__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctggtggccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatcggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16643 - RNA, 9879 nt, synthetic construct
  misc_feature 1..9879: note = derived and/or modified CDS sequence (opt4) from DENV-1__EU482808__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagagacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16644 - RNA, 9879 nt, synthetic construct
  misc_feature 1..9879: note = derived and/or modified CDS sequence (opt4) from DENV-1__EU482809__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16645 - RNA, 9879 nt, synthetic construct
  misc_feature 1..9879: note = derived and/or modified CDS sequence (opt4) from DENV-1__EU482810__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcatgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgcagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagccacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcagcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggacacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcggccccgagggcgccctgtggtga

SEQ ID NO: 16646 - RNA, 9879 nt, synthetic construct
  misc_feature 1..9879: note = derived and/or modified CDS sequence (opt4) from DENV-1__EU482811__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggtgcagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatccacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcatggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccaacgagctggagacccccaacctggccggcagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16647 - RNA, 9879 nt, synthetic construct
  misc_feature 1..9879: note = derived and/or modified CDS sequence (opt4) from DENV-1__EU482812__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgccacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16648 - RNA, 9879 nt, synthetic construct
  misc_feature 1..9879: note = derived and/or modified CDS sequence (opt4) from DENV-1__EU482813__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgaggaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16649 - RNA, 9879 nt, synthetic construct
  misc_feature 1..9879: note = derived and/or modified CDS sequence (opt4) from DENV-1__EU482814__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcttcggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16650 - RNA, 9879 nt, synthetic construct
  misc_feature 1..9879: note = derived and/or modified CDS sequence (opt4) from DENV-1__EU482815__SS-prME
  source 1..9879: mol_type = other RNA
agcgtgaccatgctgctgatgctgatgcccgccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgaccgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcttcatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16651 - RNA, 9879 nt, synthetic construct
  misc_feature 1..9879: note = derived and/or modified CDS sequence (opt4) from DENV-1__EU482816__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16652 - RNA, 9879 nt, synthetic construct
  misc_feature 1..9879: note = derived and/or modified CDS sequence (opt4) from DENV-1__EU482821__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16653 - RNA, 9879 nt, synthetic construct
  misc_feature 1..9879: note = derived and/or modified CDS sequence (opt4) from DENV-1__EU482822__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagatgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgtgcagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgaagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16654 - RNA, 9879 nt, synthetic construct
  misc_feature 1..9879: note = derived and/or modified CDS sequence (opt4) from DENV-1__EU482476__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcaccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctggccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16655 - RNA, 9879 nt, synthetic construct
  misc_feature 1..9879: note = derived and/or modified CDS sequence (opt4) from DENV-1__EU482477__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgctggccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccacctacagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgagaacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16656 - RNA, 9879 nt, synthetic construct
  misc_feature 1..9879: note = derived and/or modified CDS sequence (opt4) from DENV-1__EU482478__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16657 - RNA, 9879 nt, synthetic construct
  misc_feature 1..9879: note = derived and/or modified CDS sequence (opt4) from DENV-1__EU482479__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatctgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtggtggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgaagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16658 - RNA, 9879 nt, synthetic construct
  misc_feature 1..9879: note = derived and/or modified CDS sequence (opt4) from DENV-1__EU482480__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcacccagatcggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggccacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagatctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16659 - RNA, 9879 nt, synthetic construct
  misc_feature 1..9879: note = derived and/or modified CDS sequence (opt4) from DENV-1__EU482481__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcgtgggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaaccacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcagcgagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcatcgccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16660 - RNA, 9879 nt, synthetic construct
  misc_feature 1..9879: note = derived and/or modified CDS sequence (opt4) from DENV-1__EU482482__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccaagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16661 - RNA, 9879 nt, synthetic construct
  misc_feature 1..9879: note = derived and/or modified CDS sequence (opt4) from DENV-1__EU482485__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccaccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccgtggacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16662 - RNA, 9879 nt, synthetic construct
  misc_feature 1..9879: note = derived and/or modified CDS sequence (opt4) from DENV-1__EU482486__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcctgttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgacagcgaccccgagggcgccctgtggtga

SEQ ID NO: 16663 - RNA, 9879 nt, synthetic construct
  misc_feature 1..9879: note = derived and/or modified CDS sequence (opt4) from DENV-1__EU482487__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgccaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgaagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16664 - RNA, 9879 nt, synthetic construct
  misc_feature 1..9879: note = derived and/or modified CDS sequence (opt4) from DENV-1__EU482488__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16665 - RNA, 9879 nt, synthetic construct
  misc_feature 1..9879: note = derived and/or modified CDS sequence (opt4) from DENV-1__EU482489__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccctgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16666 - RNA, 9879 nt, synthetic construct
  misc_feature 1..9879: note = derived and/or modified CDS sequence (opt4) from DENV-1__EU482490__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcaccatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16667 - RNA, 9879 nt, synthetic construct
  misc_feature 1..9879: note = derived and/or modified CDS sequence (opt4) from DENV-1__EU482491__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcacccagatcggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggccacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagatctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16668 - RNA, 9879 nt, synthetic construct
  misc_feature 1..9879: note = derived and/or modified CDS sequence (opt4) from DENV-1__EU482493__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcgtggtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16669 - RNA, 9879 nt, synthetic construct
  misc_feature 1..9879: note = derived and/or modified CDS sequence (opt4) from DENV-1__EU482494__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatcacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggccacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16670 - RNA, 9879 nt, synthetic construct
  misc_feature 1..9879: note = derived and/or modified CDS sequence (opt4) from DENV-1__EU482495__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcctgttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgacagcgaccccgagggcgccctgtggtga

SEQ ID NO: 16671 - RNA, 9879 nt, synthetic construct
  misc_feature 1..9879: note = derived and/or modified CDS sequence (opt4) from DENV-1__EU482496__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgaagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16672 - RNA, 9879 nt, synthetic construct
  misc_feature 1..9879: note = derived and/or modified CDS sequence (opt4) from DENV-1__EU482497__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccagggcacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacaccatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16673 - RNA, 9879 nt, synthetic construct
  misc_feature 1..9879: note = derived and/or modified CDS sequence (opt4) from DENV-1__EU482499__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgaagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16674 - RNA, 9879 nt, synthetic construct
  misc_feature 1..9879: note = derived and/or modified CDS sequence (opt4) from DENV-1__EU482500__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggaggccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16675 - RNA, 9879 nt, synthetic construct
  misc_feature 1..9879: note = derived and/or modified CDS sequence (opt4) from DENV-1__EU482501__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16676 - RNA, 9879 nt, synthetic construct
  misc_feature 1..9879: note = derived and/or modified CDS sequence (opt4) from DENV-1__EU482504__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggtgaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcagcgagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16677 - RNA, 9879 nt, synthetic construct
  misc_feature 1..9879: note = derived and/or modified CDS sequence (opt4) from DENV-1__EU482505__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaaggcctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcaacagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagatcgaccccgagggcgccctgtggtga

SEQ ID NO: 16678 - RNA, 9879 nt, synthetic construct
  misc_feature 1..9879: note = derived and/or modified CDS sequence (opt4) from DENV-1__EU482506__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatcatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16679 - RNA, 9879 nt, synthetic construct
  misc_feature 1..9879: note = derived and/or modified CDS sequence (opt4) from DENV-1__EU482509__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgccggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcgtgcccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatcatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgagcccgagggcgccctgtggtga

SEQ ID NO: 16680 - RNA, 9879 nt, synthetic construct
  misc_feature 1..9879: note = derived and/or modified CDS sequence (opt4) from DENV-1__EU482510__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgagaaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacggcaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatcgccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16681 - RNA, 9879 nt, synthetic construct
  misc_feature 1..9879: note = derived and/or modified CDS sequence (opt4) from DENV-1__EU482511__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatgagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccaagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16682 - RNA, 9879 nt, synthetic construct
  misc_feature 1..9879: note = derived and/or modified CDS sequence (opt4) from DENV-1__EU482513__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16683 - RNA, 9879 nt, synthetic construct
  misc_feature 1..9879: note = derived and/or modified CDS sequence (opt4) from DENV-1__EU482515__SS-prME
  source 1..9879: mol_type = other RNA
agcgtgaccaccctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatgagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcaagaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccaagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16684 - RNA, 9879 nt, synthetic construct
  misc_feature 1..9879: note = derived and/or modified CDS sequence (opt4) from DENV-1__EU482516__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16685 - RNA, 9879 nt, synthetic construct
  misc_feature 1..9879: note = derived and/or modified CDS sequence (opt4) from DENV-1__EU482517__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaacaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgccgaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggacagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16686 - RNA, 9879 nt, synthetic construct
  misc_feature 1..9879: note = derived and/or modified CDS sequence (opt4) from DENV-1__EU482519__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatggccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaaggtggtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgaccagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16687 - RNA, 9879 nt, synthetic construct
  misc_feature 1..9879: note = derived and/or modified CDS sequence (opt4) from DENV-1__EU482520__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgagagagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacggccactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcatcctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16688 - RNA, 9879 nt, synthetic construct
  misc_feature 1..9879: note = derived and/or modified CDS sequence (opt4) from DENV-1__EU482521__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcagaatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggagaagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacatctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagatcaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16689 - RNA, 9879 nt, synthetic construct
  misc_feature 1..9879: note = derived and/or modified CDS sequence (opt4) from DENV-1__EU482523__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccaggccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaagaatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16690 - RNA, 9879 nt, synthetic construct
  misc_feature 1..9879: note = derived and/or modified CDS sequence (opt4) from DENV-1__EU482525__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagaccgaccccgagggcgccctgtggtga

SEQ ID NO: 16691 - RNA, 9879 nt, synthetic construct
  misc_feature 1..9879: note = derived and/or modified CDS sequence (opt4) from DENV-1__EU482526__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacgtgccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16692 - RNA, 9879 nt, synthetic construct
  misc_feature 1..9879: note = derived and/or modified CDS sequence (opt4) from DENV-1__EU482527__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacggcaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccttcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16693 - RNA, 9879 nt, synthetic construct
  misc_feature 1..9879: note = derived and/or modified CDS sequence (opt4) from DENV-1__EU482528__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgccatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagcacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagaggcatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16694 - RNA, 9879 nt, synthetic construct
  misc_feature 1..9879: note = derived and/or modified CDS sequence (opt4) from DENV-1__EU482529__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccctgcaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16695 - RNA, 9879 nt, synthetic construct
  misc_feature 1..9879: note = derived and/or modified CDS sequence (opt4) from DENV-1__EU482531__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccaacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16696 - RNA, 9879 nt, synthetic construct
  misc_feature 1..9879: note = derived and/or modified CDS sequence (opt4) from DENV-1__EU482532__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcaccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagaagcggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16697 - RNA, 9879 nt, synthetic construct
  misc_feature 1..9879: note = derived and/or modified CDS sequence (opt4) from DENV-1__EU482533__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtgatcgtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16698 - RNA, 9879 nt, synthetic construct
  misc_feature 1..9879: note = derived and/or modified CDS sequence (opt4) from DENV-1__EU482534__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcgtgagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16699 - RNA, 9879 nt, synthetic construct
  misc_feature 1..9879: note = derived and/or modified CDS sequence (opt4) from DENV-1__EU482535__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagatgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccagaaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatcgacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgtgcagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgaagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16700 - RNA, 9879 nt, synthetic construct
  misc_feature 1..9879: note = derived and/or modified CDS sequence (opt4) from DENV-1__EU482536__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacatgctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16701 - RNA, 9879 nt, synthetic construct
  misc_feature 1..9879: note = derived and/or modified CDS sequence (opt4) from DENV-1__EU482537__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16702 - RNA, 9879 nt, synthetic construct
  misc_feature 1..9879: note = derived and/or modified CDS sequence (opt4) from DENV-1__EU482538__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacagagagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacaccctggagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccagaccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggacagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16703 - RNA, 9879 nt, synthetic construct
  misc_feature 1..9879: note = derived and/or modified CDS sequence (opt4) from DENV-1__EU482539__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccctgcagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16704 - RNA, 9879 nt, synthetic construct
  misc_feature 1..9879: note = derived and/or modified CDS sequence (opt4) from DENV-1__KP188539__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccatcatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgtgaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgagatggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaaggacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcagcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaccaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16705 - RNA, 9879 nt, synthetic construct
  misc_feature 1..9879: note = derived and/or modified CDS sequence (opt4) from DENV-1__KP188540__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatgctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgagaacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgccaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16706 - RNA, 9879 nt, synthetic construct
  misc_feature 1..9879: note = derived and/or modified CDS sequence (opt4) from DENV-1__KP188541__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcttcatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgagaacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccgtggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16707 - RNA, 9879 nt, synthetic construct
  misc_feature 1..9879: note = derived and/or modified CDS sequence (opt4) from DENV-1__KP188543__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggtggagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgtgaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgagatggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtggtggacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16708 - RNA, 9879 nt, synthetic construct
  misc_feature 1..9879: note = derived and/or modified CDS sequence (opt4) from DENV-1__KP188544__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgtgaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgacctgcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgcaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcaccacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16709 - RNA, 9879 nt, synthetic construct
  misc_feature 1..9879: note = derived and/or modified CDS sequence (opt4) from DENV-1__KP188547__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgtgaacggcatcctggcccagggcaagaagatgatcaagccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccctggacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccagcagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggcaccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16710 - RNA, 9879 nt, synthetic construct
  misc_feature 1..9879: note = derived and/or modified CDS sequence (opt4) from DENV-1__KP723473__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagtgcgacagcagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcatccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcaccgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16711 - RNA, 9879 nt, synthetic construct
  misc_feature 1..9879: note = derived and/or modified CDS sequence (opt4) from DENV-1__KT187564__SS-prME
  source 1..9879: mol_type = other RNA
agcgtgaccatgctgctgatgctgatgcccaccgccctggccttccacctgaccaccagaggcggcgagccccacatgatggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaagggcaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgatcggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgccgagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgttccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagaagactgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcaactgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16712 - RNA, 9879 nt, synthetic construct
  misc_feature 1..9879: note = derived and/or modified CDS sequence (opt4) from DENV-1__KT187560__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16713 - RNA, 9879 nt, synthetic construct
  misc_feature 1..9879: note = derived and/or modified CDS sequence (opt4) from DENV-1__KT187561__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcctgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16714 - RNA, 9879 nt, synthetic construct
  misc_feature 1..9879: note = derived and/or modified CDS sequence (opt4) from DENV-1__KT187562__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaagaccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16715 - RNA, 9879 nt, synthetic construct
  misc_feature 1..9879: note = derived and/or modified CDS sequence (opt4) from DENV-1__JQ045628__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccacccccggcaccttcaagaccctggagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatcgccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16716 - RNA, 9879 nt, synthetic construct
  misc_feature 1..9879: note = derived and/or modified CDS sequence (opt4) from DENV-1__JQ045629__SS-prME
  source 1..9879: mol_type = other RNA
agcgtgaccatgctgctgatgctgatgcccaccgccctggccttccacctgaccaccagaggcggcgagccccacatgatggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16717 - RNA, 9879 nt, synthetic construct
  misc_feature 1..9879: note = derived and/or modified CDS sequence (opt4) from DENV-1__JQ045630__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatcgccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16718 - RNA, 9879 nt, synthetic construct
  misc_feature 1..9879: note = derived and/or modified CDS sequence (opt4) from DENV-1__JQ045632__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgaagaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatcctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaaggtgctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16719 - RNA, 9879 nt, synthetic construct
  misc_feature 1..9879: note = derived and/or modified CDS sequence (opt4) from DENV-1__JQ045633__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctggccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcgccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccagaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggtgagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagtacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16720 - RNA, 9879 nt, synthetic construct
  misc_feature 1..9879: note = derived and/or modified CDS sequence (opt4) from DENV-1__JQ045634__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctggccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcgccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccagaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggtgagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagtacgccgtgagcagaggcaccgccaagctgagatggttcgtggagagaaacctggtgaagcccgagggcaaggtgatcgacctgggctgcggcagaggcggctgggcctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16721 - RNA, 9879 nt, synthetic construct
  misc_feature 1..9879: note = derived and/or modified CDS sequence (opt4) from DENV-1__JQ045636__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgccacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccgacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgaccccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16722 - RNA, 9879 nt, synthetic construct
  misc_feature 1..9879: note = derived and/or modified CDS sequence (opt4) from DENV-1__JQ045635__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccatcgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgccacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccgacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgtggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgaccccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctgggcctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16723 - RNA, 9879 nt, synthetic construct
  misc_feature 1..9879: note = derived and/or modified CDS sequence (opt4) from DENV-1__JQ045637__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagatgagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcctgagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccgccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatcgaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16724 - RNA, 9879 nt, synthetic construct
  misc_feature 1..9879: note = derived and/or modified CDS sequence (opt4) from DENV-1__JQ045638__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagatgagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcagcagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcctgagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccgccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatcgaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctgggcctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16725 - RNA, 9879 nt, synthetic construct
  misc_feature 1..9879: note = derived and/or modified CDS sequence (opt4) from DENV-1__JQ045639__SS-prME
  source 1..9879: mol_type = other RNA
agcgtgaccatgttcctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccagagccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcagatgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16726 - RNA, 9879 nt, synthetic construct
  misc_feature 1..9879: note = derived and/or modified CDS sequence (opt4) from DENV-1__JQ045641__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtggcccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacaccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16727 - RNA, 9879 nt, synthetic construct
  misc_feature 1..9879: note = derived and/or modified CDS sequence (opt4) from DENV-1__JQ045642__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtgcgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16728 - RNA, 9879 nt, synthetic construct
  misc_feature 1..9879: note = derived and/or modified CDS sequence (opt4) from DENV-1__JQ045644__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccgccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16729 - RNA, 9879 nt, synthetic construct
  misc_feature 1..9879: note = derived and/or modified CDS sequence (opt4) from DENV-1__JQ045648__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtggcccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacaccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccacctgcaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16730 - RNA, 9879 nt, synthetic construct
  misc_feature 1..9879: note = derived and/or modified CDS sequence (opt4) from DENV-1__JQ045649__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgagagagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccagcctgctgagcctgaccttcatcaagaccaccttcagcctgcactacgcctggaagaccatggccatggtgctgagcgtggtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgaagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctgcactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16731 - RNA, 9879 nt, synthetic construct
  misc_feature 1..9879: note = derived and/or modified CDS sequence (opt4) from DENV-1__JQ045650__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgagagagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccagcctgctgagcctgaccttcatcaagaccaccttcagcctgcactacgcctggaagaccatggccatggtgctgagcgtggtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctgggcctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgaagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctgcactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16732 - RNA, 9879 nt, synthetic construct
  misc_feature 1..9879: note = derived and/or modified CDS sequence (opt4) from DENV-1__JQ045651__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagtacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16733 - RNA, 9879 nt, synthetic construct
  misc_feature 1..9879: note = derived and/or modified CDS sequence (opt4) from DENV-1__JQ045652__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagtacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16734 - RNA, 9879 nt, synthetic construct
  misc_feature 1..9879: note = derived and/or modified CDS sequence (opt4) from DENV-1__JQ045653__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcaagaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactgcgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggaggacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16735 - RNA, 9879 nt, synthetic construct
  misc_feature 1..9879: note = derived and/or modified CDS sequence (opt4) from DENV-1__JQ045657__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcaccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16736 - RNA, 9879 nt, synthetic construct
  misc_feature 1..9879: note = derived and/or modified CDS sequence (opt4) from DENV-1__JQ045659__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgccacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgaccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggccgtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcatggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagaaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagagacccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16737 - RNA, 9879 nt, synthetic construct
  misc_feature 1..9879: note = derived and/or modified CDS sequence (opt4) from DENV-1__JQ045661__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgacctggaacgacctgatcagactgtgcatcatgatcggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcgtggtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagtacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16738 - RNA, 9879 nt, synthetic construct
  misc_feature 1..9879: note = derived and/or modified CDS sequence (opt4) from DENV-1__JQ045663__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccagcacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaacagcaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcctgctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16739 - RNA, 9879 nt, synthetic construct
  misc_feature 1..9879: note = derived and/or modified CDS sequence (opt4) from DENV-1__JQ045665__SS-prME
  source 1..9879: mol_type = other RNA
agcgtgaccatgctgctgatgctgatgcccaccgccctggccttccacctgaccgccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgccacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtgaacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagactgagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcaccacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagagcttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaagacacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccacctgcaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16740 - RNA, 9879 nt, synthetic construct
  misc_feature 1..9879: note = derived and/or modified CDS sequence (opt4) from DENV-1__JQ045666__SS-prME
  source 1..9879: mol_type = other RNA
agcgtgaccatgctgctgatgctgatgcccaccgccctggccttccacctgaccgccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgccacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtgaacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagactgagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcaccacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagagcttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaagacacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16741 - RNA, 9879 nt, synthetic construct
  misc_feature 1..9879: note = derived and/or modified CDS sequence (opt4) from DENV-1__JQ045667__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccaacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaagggcaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatggcctgctacgtgatcagcggcagcagcgccgacctgagcctggagaaggccgccgaggtgagctgggaggaggaggccgagcacagcggcgccagccacaacatcctggtggaggtgcagggcgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccatccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16742 - RNA, 9879 nt, synthetic construct
  misc_feature 1..9879: note = derived and/or modified CDS sequence (opt4) from DENV-1__KU094071__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccaaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcggcacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaagagaaagagctggctggtgcacaagcagtggttcctggacctgcccctgccctggaccagcggcgccagcaccccccaggagacctggaacagagaggacctgctggtgaccttcaagaccgcccacgccaagaagcaggaggtggtggtgctgggcagccaggagggcgccatgcacaccgccctgaccggcgccaccgagatccagaccagcggcaccaccaagatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgctggaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcgccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttcagagccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctgacccagggcagaaagatgatcggcccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccccagactgatgagcgccgccatcaaggacagcaaggccgtgcacgccgacatgggctactggatcgagagcgagaagaacgagacctggagactggccagagccagcttcatcgaggtgaagacctgcgtgtggcccaagagccacaccctgtggagcaacggcgtgctggagagcgagatgatcatccccaagatctacggcggccccatcagccagcacaactacagacccggctacagcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggacaaggaggagaacctggtgaagagcctggtgagcgccggcagcggcgaggtggacagcttcagcctgggcctgctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatcgccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccgccctgctgagcctgaccttcatcaagaccaccttcagcctgcactacgcctggaagaccatggccatggtgctgagcaccgtgagcctgttccccctgtgcctgagcaccaccagcagaaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatcagcatccccgccaccctgttcgtgtggtacttcagacagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgtgatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcagcaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagaggcaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaaagtggtgcttcgacggcgagagaaacaaccaggtgctggaggagaacatggacgtggagatctggaccaaggagggcgagagaaagaagctgagacccagatggctggacgccagaacctacagcgacccccaggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtgggtggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaacccccccaccctgatcgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgagcatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttccccctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccatcgactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaaggacgagagcgacctggagggcgccctgtggtga

SEQ ID NO: 16743 - RNA, 9879 nt, synthetic construct
  misc_feature 1..9879: note = derived and/or modified CDS sequence (opt4) from DENV-1__HQ624983__SS-prME
  source 1..9879: mol_type = other RNA
agcgtgaccatgctgctgatgctggtgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcagcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccacctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcgtgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatcagcggcggcaacatgtacgccgacgacaccgccggctgggacaccagaatcaccgaggacgacctgcagaacgaggccaagatcaccgacatcatggagcccgagcacgccctgctggccaacagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccgccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16744 - RNA, 9879 nt, synthetic construct
  misc_feature 1..9879: note = derived and/or modified CDS sequence (opt4) from DENV-1__FJ384655__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgagcagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactggccagcagagaggtgctgctgctgaccatcggcctgagcctggtggccagcgtggagctgcccaacagcctggaggagctgggcgacggcctggccatgggcatcatgatgctgaagctgctgaccgagttccagccccaccacctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcgccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagggcgccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgagcagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcggctacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccgtgcccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16745 - RNA, 9879 nt, synthetic construct
  misc_feature 1..9879: note = derived and/or modified CDS sequence (opt4) from DENV-1__KC759167__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcgtgacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggcccccgaggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccaagccccccttcggcgagagctgcatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcacccccccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcgccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaaagctgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggagaaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgagggcgtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagtacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagacctacgtggagctgatgagaagaggcgacctgcccgtgtggctgagctacaaggtggccagcgagggcttccagtacagcgacagaagatggtacttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagctggagttcaacagctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcagcagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccagcgagctggagacccccaacctggccgagagagtgctggactggctggagaagtacggcatcgagagactgaagagaatggccatcagcggcgacgactgcgtggtgaagcccatcgacaacagattcgccaccgccctgaccgccctgaacgacatgggcaaggtgagaaaggacatcccccagtgggagcccagcaagggctggaacgactggcagcaggtgcccctgtgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16746 - RNA, 9879 nt, synthetic construct
  misc_feature 1..9879: note = derived and/or modified CDS sequence (opt4) from DENV-1__JQ048541__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaagctgagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaaggtgctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggggcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16747 - RNA, 9879 nt, synthetic construct
  misc_feature 1..9879: note = derived and/or modified CDS sequence (opt4) from DENV-1__JN697056__SS-prME
  source 1..9879: mol_type = other RNA
agcgtgaccatgctgctgatgctgctgcccaccgccctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacatcggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggccccttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagagcatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcaagaagatgctgatgaccggcaccctggccgtgttcctgctgctgaccatgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcgtgaagaccaccttcagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggtacttctggcagaagagaaagcagagaagcggcgtgctgtgggacacccccagcccccccgaggtggagagagccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatcctggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatgagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcgtggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatgggcgcccagctgatcagacagatggagagcgagggcatcttcctgcccagcgagctggagacccccaacctggccggcagagtgctggactggctggagaagcacggcatcgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16748 - RNA, 9879 nt, synthetic construct
  misc_feature 1..9879: note = derived and/or modified CDS sequence (opt4) from DENV-1__JN697057__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatctgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaaggtgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggtgaccctgctgagcctgaccttcatcaagaccgccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagagaaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggccgcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtggtggacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccaagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16749 - RNA, 9879 nt, synthetic construct
  misc_feature 1..9879: note = derived and/or modified CDS sequence (opt4) from DENV-1__HQ624984__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagagcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccctgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcaccgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16750 - RNA, 9879 nt, synthetic construct
  misc_feature 1..9879: note = derived and/or modified CDS sequence (opt4) from DENV-1__HQ891314__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaccgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagaactggggcaaggccaagatcatcggcgccgacgtgcagaacagcaccttcatcatcgacggccccaacacccccgagtgcagcgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcatgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccaaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagatgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagagtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16751 - RNA, 9879 nt, synthetic construct
  misc_feature 1..9879: note = derived and/or modified CDS sequence (opt4) from DENV-1__HQ891315__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagaactggggcaaggccaagatcatcggcgccgacgtgcagaacagcaccttcatcatcgacggccccaacacccccgagtgcagcgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatcgtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcatgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccaaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagatgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagagtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16752 - RNA, 9879 nt, synthetic construct
  misc_feature 1..9879: note = derived and/or modified CDS sequence (opt4) from DENV-1__HQ891316__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagaactggggcaaggccaagatcatcggcgccgacgtgcagaacagcaccttcatcatcgacggccccaacacccccgagtgcagcgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcatgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccaaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagatgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagagtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16753 - RNA, 9879 nt, synthetic construct
  misc_feature 1..9879: note = derived and/or modified CDS sequence (opt4) from DENV-1__JN054256__SS-prME
  source 1..9879: mol_type = other RNA
agcgtgaccatgctgctgatgctgatgcccaccgccctggccttccacctgaccaccagagagggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaccgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagcacaagtacagctggaagaactggggcaaggccaagatcatcggcgccgacgtgcagaacagcaccttcatcatcgacggccccaacacccccgagtgcagcgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgatcgacttccagagccaccagctgtgggccaccctgctgagcatgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccaaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagatgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagagtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16754 - RNA, 9879 nt, synthetic construct
  misc_feature 1..9879: note = derived and/or modified CDS sequence (opt4) from DENV-1__JN054255__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagatgagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagaactggggcaaggccaagatcatcggcgccgacgtgcagaacagcaccttcatcatcgacggccccaacacccccgagtgcagcgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcatgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccaaggtggagaaggccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcggcatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagatgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgagaaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcatggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccagcaagaacggcaccgtgatggacgtgatcagcagaagagaccagagaggcagcggccaggtgggcacctacggcctgaacaccttcaccaacatggaggcccagctgatcagacagatggagagcgaggagatcttcagccccaacgagctggagacccccaacctggccaagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagagtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16755 - RNA, 9879 nt, synthetic construct
  misc_feature 1..9879: note = derived and/or modified CDS sequence (opt4) from DENV-1__KP406801__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacaccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctggccggcgccaccgagatccagatgagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcatccaggacgagaagggcgtgacccagaacggcagactgatcaccgccaaccccatcgccaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatcgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgagacccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagaagttctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16756 - RNA, 9879 nt, synthetic construct
  misc_feature 1..9879: note = derived and/or modified CDS sequence (opt4) from DENV-1__KP406802__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagatctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16757 - RNA, 9879 nt, synthetic construct
  misc_feature 1..9879: note = derived and/or modified CDS sequence (opt4) from DENV-1__KP406803__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactgatcaccgccaaccccatcgtgaccgacaaggagaagcccgtgaacatcgaggccgagccccccttcggcgagagctacctggtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgaacggcatcctggcccagggcaagaagatgatcagaccccagcccatggagcacaagtacagctggaagagctggggcaaggccaaggtgatcggcgccgacgtgcagaacatcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctgaccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcggcctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagagccaccagctgtgggccgccctgctgagcctgaccttcgtgaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcaagagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatccccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcatggaggccttcccccagagcaacgccgccatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtggtgcagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagagccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgagaatggtggagccctggctgagaggcaaccagttctgcatcaaggtgctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16758 - RNA, 9879 nt, synthetic construct
  misc_feature 1..9879: note = derived and/or modified CDS sequence (opt4) from DENV-1__KJ438293__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagatcagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccggcttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtggtgctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatcgccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatcctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactggatcagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16759 - RNA, 9879 nt, synthetic construct
  misc_feature 1..9879: note = derived and/or modified CDS sequence (opt4) from DENV-1__KJ438296__SS-prME
  source 1..9879: mol_type = other RNA
agcgtgaccatgctgctgatgctgatgcccaccgccctggccttccacctgaccaccagaggcggcgagccccacatgatggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgatcggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgccgagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgatccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgttccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagaagactgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcaactgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16760 - RNA, 9879 nt, synthetic construct
  misc_feature 1..9879: note = derived and/or modified CDS sequence (opt4) from DENV-1__KC692495__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16761 - RNA, 9879 nt, synthetic construct
  misc_feature 1..9879: note = derived and/or modified CDS sequence (opt4) from DENV-1__KC692496__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggagacagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgctggccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16762 - RNA, 9879 nt, synthetic construct
  misc_feature 1..9879: note = derived and/or modified CDS sequence (opt4) from DENV-1__KC692497__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcaccggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacgtgatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16763 - RNA, 9879 nt, synthetic construct
  misc_feature 1..9879: note = derived and/or modified CDS sequence (opt4) from DENV-1__KC692498__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcaccggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttcagcggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacgtgatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16764 - RNA, 9879 nt, synthetic construct
  misc_feature 1..9879: note = derived and/or modified CDS sequence (opt4) from DENV-1__KC692499__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgtgaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagtacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcgccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16765 - RNA, 9879 nt, synthetic construct
  misc_feature 1..9879: note = derived and/or modified CDS sequence (opt4) from DENV-1__KC692500__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaagggcaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattcaagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16766 - RNA, 9879 nt, synthetic construct
  misc_feature 1..9879: note = derived and/or modified CDS sequence (opt4) from DENV-1__KC692501__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagaggagaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16767 - RNA, 9879 nt, synthetic construct
  misc_feature 1..9879: note = derived and/or modified CDS sequence (opt4) from DENV-1__KC692502__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgagaaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgagatggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccatgagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcagccaggtgagaagactgatcggcaacgagaactacctggactacatgaccagcatgaagagattcaagaacgagagcgaccccgagggcgccctgtggtga

SEQ ID NO: 16768 - RNA, 9879 nt, synthetic construct
  misc_feature 1..9879: note = derived and/or modified CDS sequence (opt4) from DENV-1__KC692503__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacagactgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatctgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgatcggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagaggagaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16769 - RNA, 9879 nt, synthetic construct
  misc_feature 1..9879: note = derived and/or modified CDS sequence (opt4) from DENV-1__KC692504__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggagacagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgatgaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacgtgttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16770 - RNA, 9879 nt, synthetic construct
  misc_feature 1..9879: note = derived and/or modified CDS sequence (opt4) from DENV-1__KC692508__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggagcacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16771 - RNA, 9879 nt, synthetic construct
  misc_feature 1..9879: note = derived and/or modified CDS sequence (opt4) from DENV-1__KC692509__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgagaaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgagatggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcagccaggtgagaagactgatcggcaacgagaactacctggactacatgaccagcatgaagagattcaagaacgagagcgaccccgagggcgccctgtggtga

SEQ ID NO: 16772 - RNA, 9879 nt, synthetic construct
  misc_feature 1..9879: note = derived and/or modified CDS sequence (opt4) from DENV-1__KC692510__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggagacagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16773 - RNA, 9879 nt, synthetic construct
  misc_feature 1..9879: note = derived and/or modified CDS sequence (opt4) from DENV-1__KC692511__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagaactgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacatcaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccaacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16774 - RNA, 9879 nt, synthetic construct
  misc_feature 1..9879: note = derived and/or modified CDS sequence (opt4) from DENV-1__KC692512__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagaggagaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacagcaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacagaagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16775 - RNA, 9879 nt, synthetic construct
  misc_feature 1..9879: note = derived and/or modified CDS sequence (opt4) from DENV-1__KC692513__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccccccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacatcaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagccacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccagcctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccacccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggagggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagaaggtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcagcgagaactacctggactacatgaccagcatgaagagattcaagaacgagagcgaccccgagggcgccctgtggtga

SEQ ID NO: 16776 - RNA, 9879 nt, synthetic construct
  misc_feature 1..9879: note = derived and/or modified CDS sequence (opt4) from DENV-1__KC692514__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggagacagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16777 - RNA, 9879 nt, synthetic construct
  misc_feature 1..9879: note = derived and/or modified CDS sequence (opt4) from DENV-1__KC692515__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcggcaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatcttcggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagaggagaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacagcaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacagaagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccgccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16778 - RNA, 9879 nt, synthetic construct
  misc_feature 1..9879: note = derived and/or modified CDS sequence (opt4) from DENV-1__KC692516__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacaacttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcctggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggcctgcgtgaagaaggacctgatcagctacggcggcggctggagattccagggcctgtggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagcagaggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaagcagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16779 - RNA, 9879 nt, synthetic construct
  misc_feature 1..9879: note = derived and/or modified CDS sequence (opt4) from DENV-1__KC692517__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccatcgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccccccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagagcgtgaacatcgagaccgagccccccttcggcgagagctacatcgtggtgggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaaccccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccaaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctggtgagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16780 - RNA, 9879 nt, synthetic construct
  misc_feature 1..9879: note = derived and/or modified CDS sequence (opt4) from DENV-1__KC762649__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcgccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgagcaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcatcttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16781 - RNA, 9879 nt, synthetic construct
  misc_feature 1..9879: note = derived and/or modified CDS sequence (opt4) from DENV-1__KC762625__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgagcaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagagctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16782 - RNA, 9879 nt, synthetic construct
  misc_feature 1..9879: note = derived and/or modified CDS sequence (opt4) from DENV-1__KC762635__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16783 - RNA, 9879 nt, synthetic construct
  misc_feature 1..9879: note = derived and/or modified CDS sequence (opt4) from DENV-1__KC762650__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatcgaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16784 - RNA, 9879 nt, synthetic construct
  misc_feature 1..9879: note = derived and/or modified CDS sequence (opt4) from DENV-1__KC762623__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgagcaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagagctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcctgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16785 - RNA, 9879 nt, synthetic construct
  misc_feature 1..9879: note = derived and/or modified CDS sequence (opt4) from DENV-1__KC762632__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatgcagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacatcaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggaccagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16786 - RNA, 9879 nt, synthetic construct
  misc_feature 1..9879: note = derived and/or modified CDS sequence (opt4) from DENV-1__KC762637__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16787 - RNA, 9879 nt, synthetic construct
  misc_feature 1..9879: note = derived and/or modified CDS sequence (opt4) from DENV-1__KC762620__SS-prME
  source 1..9879: mol_type = other RNA
agcgtgaccatgctgttcatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccatcgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagagaggcgtgatccagaacggcagactgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaaacaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacaaccagagagcctggaacatctgggaggtggaggactacggcttcggcgtgttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggagagagccagcttcatcgaggtgaagacctgcatctggcccagaagccacaccctgtggagcaacggcgtgctggagagcgagatgatcatccccaagacctacggcggccccgtgagccagcacaactacagacccggctacttcacccagaccgccggcccctggcacctgggcaagctggagctggacttcgacctgtgcgagggcaccaccgtggtggtggacgagaactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcggcaagatgctgatgaccggcaccctggccgtgttcctgctgctgaccatgggccagctgacctggaacgacctgatcagactgtgcatcatggtgggcgccaacgccagcgacatgatgggcatgggcaccacctacctggccctgatggccaccttcagaatgagacccatgttcgccgtgggcctgctgttcagaagactgaccagcagagaggtgctgctgctgaccgtgggcctgagcctggccgccagcgtggagctgcccaacagcctggaggagctgggcgacggcctggccatgggcatcatgatgctgaagctgctgaccgacttccagagccaccagctgtgggccaccctgctgagcctgaccttcgtgaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgctgctgatcaccgagaacaagatctggggcagaagaagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggacgaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcctgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtggtgcagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaacagcaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagaaggcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccgtgcccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacctgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccaagagagtgctggactggctggagaagcacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctgatcggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagagcgaccccgagggcgccctgtggtga

SEQ ID NO: 16788 - RNA, 9879 nt, synthetic construct
  misc_feature 1..9879: note = derived and/or modified CDS sequence (opt4) from DENV-1__KC762631__SS-prME
  source 1..9879: mol_type = other RNA
agcgtgaccatgctgctgatgctgatgcccaccgccctggccttccacctgaccaccagaggcggcgagccccacatgaccgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacctgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacctgggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgagaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggagctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16789 - RNA, 9879 nt, synthetic construct
  misc_feature 1..9879: note = derived and/or modified CDS sequence (opt4) from DENV-1__KC762621__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16790 - RNA, 9879 nt, synthetic construct
  misc_feature 1..9879: note = derived and/or modified CDS sequence (opt4) from DENV-1__KC762643__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatggccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgctgaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcatcagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaaggcccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16791 - RNA, 9879 nt, synthetic construct
  misc_feature 1..9879: note = derived and/or modified CDS sequence (opt4) from DENV-1__KC762651__SS-prME
  source 1..9879: mol_type = other RNA
agcgtgaccatgctgttcatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagagaggcgtgatccagaacggcagactgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacaaccagagagcctggaacatctgggaggtggaggactacggcttcggcgtgttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggagagagccagcttcatcgaggtgaagacctgcatctggcccagaagccacaccctgtggagcaacggcgtgctggagagcgagatgatcatccccaagacctacggcggccccgtgagccagcacaactacagacccggctacttcacccagaccgccggcccctggcacctgggcaagctggagctggacttcaacctgtgcgagggcaccaccgtggtggtggacgagaactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcggcaagatgctgatgaccggcaccctggccgtgttcctgctgctgaccatgggccagctgacctggaacgacctgatcagactgtgcatcatggtgggcgccaacgccagcgacatgatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagagccaccagctgtgggccaccctgctgagcctgaccttcgtgaagaccgccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgctgctgatcaccgagaacaagatctggggcagaagaagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggacgaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcctgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtggtgcagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccccaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagaaggcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccgtgcccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacctgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccaagagagtgctggactggctggagaagcacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctgatcggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagagcgaccccgagggcgccctgtggtga

SEQ ID NO: 16792 - RNA, 9879 nt, synthetic construct
  misc_feature 1..9879: note = derived and/or modified CDS sequence (opt4) from DENV-1__KC762653__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgctaccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactgatcaccgccaaccccatcgtgaccgacaaggagaagcccgtgaacatcgaggccgagccccccttcggcgagagctacctggtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatgatcaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgaggtgaacggcatcctggcccagggcaagaagatgatcagaccccagcccatggagcacaagtacagctggaagagctggggcaaggccaaggtgatcggcgccgacgtgcagaacaccaccttcatcatcgacggccccaacacccccgagtgccccgacaaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgagctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgaccatgggccagctgacctggaacgacctgatcagactgtgcatcatggtgggcgccaacgccagcgacaagatgggcatgggcaccacctacctggccctgatggccaccttcagaatgagacccatgctggccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagagccaccagctgtgggccgccctgctgagcctgaccttcgtgaagaccaccctgagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagaaggccgtgctggacgacggcatctacagaatcctgcagagaggcctgctgggcaagagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcatggaggccttcccccagagcaacgccgccatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaaggtgctgaacccctacatgcccagcgtgatcgagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcacccccagcgagctggagacccccaacctggccgagagagtgctggactggctggagaagcacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16793 - RNA, 9879 nt, synthetic construct
  misc_feature 1..9879: note = derived and/or modified CDS sequence (opt4) from DENV-1__KC762640__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactgatcaccgccaaccccatcgtgaccgacaaggagaagcccgtgaacatcgaggccgagccccccttcggcgagagctacctggtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgaggtgaacggcatcctggcccagggcaagaagatgatcagaccccagcccatggagcacaagtacagctggaagagctggggcaaggccaaggtgatcggcgccgacgtgcagaacaccaccttcatcatcgacggccccaacacccccgagtgccccgacaaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgagctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgaccatgggccagctgacctggaacgacctgatcagactgtgcatcatggtgggcgccaacgccagcgacaagatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagagccaccagctgtgggccgccctgctgagcctgaccttcgtgaagaccaccctgagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagaaggccgtgctggacgacggcatctacagaatcctgcagagaggcctgctgggcaagagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcatggaggccttcccccagagcaacgccgccatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgagaatggtggagccctggctgagaggcaaccagttctgcatcaaggtgctgaacccctacatgcccagcgtgatcgagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggagatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcacccccagcgagctggagacccccaacctggccgagagagtgctggactggctggagaagcacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16794 - RNA, 9879 nt, synthetic construct
  misc_feature 1..9879: note = derived and/or modified CDS sequence (opt4) from DENV-1__KC762645__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtgcagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16795 - RNA, 9879 nt, synthetic construct
  misc_feature 1..9879: note = derived and/or modified CDS sequence (opt4) from DENV-1__KC762628__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactgatcaccgccaaccccatcgtgaccgacaaggagaagcccgtgaacatcgaggccgagccccccttcggcgagagctacctggtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgaggtgaacggcatcctggcccagggcaagaagatgatcagaccccagcccatggagcacaagtacagctggaagagctggggcaaggccaaggtgatcggcgccgacgtgcagaacaccaccttcatcatcgacggccccaacacccccgagtgccccgacaaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgagctgtgcgagggcaccaccgtggtggtggacgagcactgcggcagcagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatgagcatcatgatcgaggaggtgatgagaagcagatggagcagaaagatgctgatgaccggcaccctggccgtgttcctgctgctgaccatgggccagctgacctggaacgacctgatcagactgtgcatcatggtgggcgccaacgccagcgacaagatgggcatgggcaccacccacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagagccaccagctgtgggccgccctgctgagcctgaccttcgtgaagaccaccctgagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcaagagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcatcgaggccttcccccagagcaacgccgccatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgagaatggtggagccctggctgagaggcaaccagttctgcatcaaggtgctgaacccctacatgcccagcgtgatcgagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcacccccagcgagctggagacccccaacctggccgagagagtgctggactggctggagaagcacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16796 - RNA, 9879 nt, synthetic construct
  misc_feature 1..9879: note = derived and/or modified CDS sequence (opt4) from DENV-1__KC762624__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16797 - RNA, 9879 nt, synthetic construct
  misc_feature 1..9879: note = derived and/or modified CDS sequence (opt4) from DENV-1__KC762644__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcgagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16798 - RNA, 9879 nt, synthetic construct
  misc_feature 1..9879: note = derived and/or modified CDS sequence (opt4) from DENV-1__KC762630__SS-prME
  source 1..9879: mol_type = other RNA
agcgtgaccgtgctgttcatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccatcatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgatccagaacggcagactgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacaaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccgtgagccagcacaactacagacccggctacttcacccagaccgccggcccctggcacctgggcaagctggagctggacttcgacctgtgcgagggcaccaccgtggtggtggacgagaactgcggcaacagaggccccagcctgagaaccaccaccgtgaccggcaagaccatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgaccatgggccagctgacctggaacgacctgatcagactgtgcatcatggtgggcgccaacgccagcgacatgatgggcatgggcaccacctacctggccctgatggccaccttcagaatgagacccatgttcgccgtgggcctgctgttcagaagactgaccagcagagagatcctgctgctgaccgtgggcctgagcctggtggccagcgtggagctgcccaacagcctggaggagctgggcgacggcctggccatgggcatcatgatgctgaagctgctgaccgacttccagccccaccagctgtgggccaccctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaagaagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggacgaggccgagcacagcggcgccagccacaacatcctggtggaggtgcaggacgacggcaccatgaagatcaaggacgaggagagagacgacaccctgaccatcctgctgaaggccaccctgctggtgatcagcggcgtgtaccccatgagcgtgcccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgagatcggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggtgagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtggtgcagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccccaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgaaggcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtgatctacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccggcaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgttcgactggctggagaagcacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16799 - RNA, 9879 nt, synthetic construct
  misc_feature 1..9879: note = derived and/or modified CDS sequence (opt4) from DENV-1__KC762641__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtgaccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16800 - RNA, 9879 nt, synthetic construct
  misc_feature 1..9879: note = derived and/or modified CDS sequence (opt4) from DENV-1__KC762648__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16801 - RNA, 9879 nt, synthetic construct
  misc_feature 1..9879: note = derived and/or modified CDS sequence (opt4) from DENV-1__KC762622__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatggccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcatcagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaaggcccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16802 - RNA, 9879 nt, synthetic construct
  misc_feature 1..9879: note = derived and/or modified CDS sequence (opt4) from DENV-1__KC762629__SS-prME
  source 1..9879: mol_type = other RNA
agcgtgaccatgctgctgatgctgatgcccaccgccctggccttccacctgaccaccagaggcggcgagccccacatggtggtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaagaccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagaggcaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16803 - RNA, 9879 nt, synthetic construct
  misc_feature 1..9879: note = derived and/or modified CDS sequence (opt4) from DENV-1__KC762627__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatgatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagaccagcaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16804 - RNA, 9879 nt, synthetic construct
  misc_feature 1..9879: note = derived and/or modified CDS sequence (opt4) from DENV-1__KC762647__SS-prME
  source 1..9879: mol_type = other RNA
agcgtgaccatgctgctgatgctgacccccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcagagccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagaaggcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaaggtgctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagcccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16805 - RNA, 9879 nt, synthetic construct
  misc_feature 1..9879: note = derived and/or modified CDS sequence (opt4) from DENV-1__KC762639__SS-prME
  source 1..9879: mol_type = other RNA
agcgtgaccatgctgctgatgctgacccccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcagagccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagagtgggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagaaggcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaaggtgctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16806 - RNA, 9879 nt, synthetic construct
  misc_feature 1..9879: note = derived and/or modified CDS sequence (opt4) from DENV-1__KC762642__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccacccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatcaccggcaccctggccgtgttcttcctgctgatcatgggccaggtgacctggaacgacctgaccagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagtacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccgtgttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctgtactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16807 - RNA, 9879 nt, synthetic construct
  misc_feature 1..9879: note = derived and/or modified CDS sequence (opt4) from DENV-1__JQ915077__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagaccatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgaccctgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggacgagctgggcgacggcctggccatgggcatcatgatcctgaagctgctgaccgacttccagagccaccagctgtgggccatcctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggcacttctggcagaagaagaagcagagaagcggcgtgctgtgggacacccccagcccccccgaggtggagaaggccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccatcatgctgctggccctgatcgccgtgctgaccggcggcgtgaccctgttcttcctgagcggcagaggcctgggcaagaccagcatcggcctgctgtgcgtgaccagcagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcaccgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16808 - RNA, 9879 nt, synthetic construct
  misc_feature 1..9879: note = derived and/or modified CDS sequence (opt4) from DENV-1__JQ915079__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccaccggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagagacccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagaccatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgaccctgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggacgagctgggcgacggcctggccatgggcatcatgatcctgaagctgctgaccgacttccagagccaccagctgtgggccaccctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggcacttctggcagaagaagaagcagagaagcggcgtgctgtgggacacccccagcccccccgaggtggagaaggccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacatgggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccatcatgctgctggccctgatcgccgtgctgaccggcggcgtgaccctgttcttcctgagcggcagaggcctgggcaagaccagcatcggcctgctgtgcgtgaccagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacaccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagccagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggaggacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcatcgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16809 - RNA, 9879 nt, synthetic construct
  misc_feature 1..9879: note = derived and/or modified CDS sequence (opt4) from DENV-1__JQ915080__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccaccggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagagacccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagaccatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgaccctgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggacgagctgggcgacggcctggccatgggcatcatgatcctgaagctgctgaccgacttccagagccaccagctgtgggccaccctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggcacttctggcagaagaagaagcagagaagcggcgtgctgtgggacacccccagcccccccgaggtggagaaggccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacatgggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccatcatgctgctggccctgatcgccgtgctgaccggcggcgtgaccctgttcttcctgagcggcagaggcctgggcaagaccagcatcggcctgctgtgcgtgaccagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatcatcctgaccgtggccgccaacgagatgggcctgctggagaccaccaagaaggacctgggcatcggccacaccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagccagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggaggacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcatcgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16810 - RNA, 9879 nt, synthetic construct
  misc_feature 1..9879: note = derived and/or modified CDS sequence (opt4) from DENV-1__KJ755855__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggagctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcgagctgttcggcaagggcagcctgctgacctgcgccaagttcaagtgcgtgaccaagctggagggcaagatcgtgcagtacgagaacctgaagtacagcgtgatcgtgaccgtgcacatcgccgcccagcaccaggtgggcaacgagagcaccgagcacggcaccaccgccatcatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagactgttcctgctggtgaccttcaagaccgcccacgccaagaagcaggaggtggtggtgctgggcagccaggagggcgccatgcacaccgccctgaccggcgccaccgccctgcagaccttcggcaccaccaccatcttcgccggccacctgaacatcagactgaagatggacaagctgaccctgaagggcatgagctacgtgatgtgcaccggcagcttcaagctggagaaggaggtggccgagacccagcacggcaccatcctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacctgaagttcaccgtggtggtgggcgacgtggccggcatcctggcccagggcaagaagatgatcagaccccagcccatggagcacaagtacagctggaagaactggggcaaggccaagatcatcggcgccgacgtgcagaacagcaccttcatcatcgacggccccaacacccccgagtgcagcgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagccccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggtgagcctgagcctgggcctgctgtgcatcagcatcatgatcgaggaggtgatgagaagcagatggagcagaaagatgctgatgaccggcaccctggccgtgttcttcagaaagatcagaggccagctgacctggaacgacctgatcagactgtgcatcatggtgggcgccaacgccagcgacagaatgggcaccagaaccacctacctggccctgatggccaccttcaagatgagacccatgttcagcgtgggcctgctgttcagaagactgaccagcagagaggtgctgctgctgaccatcggcctgagcctggtggccagcgtggagctgcccaacagcctggaggagctgggcgtgctgctggccatgggcatcatgatcctgaccctgctgaccgacttccagagccaccagctgtgggccaccctgctgagcatgaccttcatcaagaccaccttcagcctgcactacacctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccaaggtggagaaggccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctggggcagagtgaagaaggacctgatcagctacggcggcggctggggcctgaagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccacgccaaggccagccaggagggccccctgcccgagaccgaggtggaggccttcagaaagagaaacctgaccatcatggacctgcaccccggcagcggcaagaccagaagatacctgcccgccatcgtgagagaggccatcaagagaaagatgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcctggccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttccccgccgacagagtgatcgaccccagaagatgcctgaaccccgtgatcctgaaggacggccccgagagagtgatcctggccggccccatgcccgtgaccgtggccagcgccaaccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagaagaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaaggccggcaacggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcagactgctgttcatgatcctgaccgtggccgccaacgagatgggcctgctggagaccaccaagaaggacctgggcatcggccacgccgccgtggagaaccaccaccacgccgccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggcttcctgagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgagccccctgtgggagggcagccccggcaagagctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagaccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgagcgaggtgagaggctacaccaagggcggccccggccacgaggagcccatccccatggccacctacggctgggacctgctgaagagatgcagcggcaaggagttcttcttcatcccccccgagaagtgcgacagcttcctgggcgacatcggcgagagcagccccaaccccaccatcgaggagggcagaaccgtgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgaggagatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctggtgatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagagtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16811 - RNA, 9879 nt, synthetic construct
  misc_feature 1..9879: note = derived and/or modified CDS sequence (opt4) from DENV-1__KF289073__SS-prME
  source 1..9879: mol_type = other RNA
agcgtgaccatgctgttcatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaagaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccacagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacatgggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagaaagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaaggccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccaccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctgatgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16812 - RNA, 9879 nt, synthetic construct
  misc_feature 1..9879: note = derived and/or modified CDS sequence (opt4) from DENV-1__JQ915072__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccaccggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagaccatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggccacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgaccctgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggacgagctgggcgacggcctggccatgggcatcatgatcctgaagctgctgaccgacttccagagccaccagctgtgggccaccctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggcacttctggcagaagaagaagcagagaagcggcgtgctgtgggacacccccagcccccccgaggtggagaaggccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacatgggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccatcatgctgctggccctgatcgccgtgctgaccggcggcgtgaccctgttcttcctgagcggcagaggcctgggcaagaccagcatcggcctgctgtgcgtgaccagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacaccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcagcagaagaggcaccggcgcccagggcgagaccctgggcgagaagtggaagagacagctgaaccagctgagcaagagcgagttcaacatctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggaggacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcatcgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaagcaggtgagaagactgatcggcaacgagaactacctggactacatgaccagcatgaagagattcaagaacgagagcgaccccgagggcgccctgtggtga

SEQ ID NO: 16813 - RNA, 9879 nt, synthetic construct
  misc_feature 1..9879: note = derived and/or modified CDS sequence (opt4) from DENV-1__JQ915071__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgccaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccaccggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagagacccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagaccatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgaccctgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggacgagctgggcgacggcctggccatgggcatcatgatcctgaagctgctgaccgacttccagagccaccagctgtgggccaccctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggcacttctggcagaagaagaagcagagaagcggcgtgctgtgggacacccccagcccccccgaggtggagaaggccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcagcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccatcatgctgctggccctgatcgccgtgctgaccggcggcgtgaccctgttcttcctgagcggcagaggcctgggcaagaccagcatcggcctgctgtgcgtgaccagcagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacaccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatcgaggtggacagaagcgaggccagagagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggaggacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcatcgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16814 - RNA, 9879 nt, synthetic construct
  misc_feature 1..9879: note = derived and/or modified CDS sequence (opt4) from DENV-1__JQ915073__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcttccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccaccggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagaccatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggccacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgaccctgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggacgagctgggcgacggcctggccatgggcatcatgatcctgaagctgctgaccgacttccagagccaccagctgtgggccaccctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggcacttctggcagaagaagaagcagagaagcggcgtgctgtgggacacccccagcccccccgaggtggagaaggccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgccgaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccatcatgctgctggccctgatcgccgtgctgaccggcggcgtgaccctgttcttcctgagcggcagaggcctgggcaagaccagcatcggcctgctgtgcgtgaccagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacaccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggaggacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcatcgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16815 - RNA, 9879 nt, synthetic construct
  misc_feature 1..9879: note = derived and/or modified CDS sequence (opt4) from DENV-1__JQ915075__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgccaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccaccggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagagacccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagaccatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgaccctgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggacgagctgggcgacggcctggccatgggcatcatgatcctgaagctgctgaccgacttccagagccaccagctgtgggccaccctgctgagcctgaccttcgtgaagaccaccctgagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggcacttctggcagaagaagaagcagagaagcggcgtgctgtgggacacccccagcccccccgaggtggagaaggccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcatcttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcagcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccatcatgctgctggccctgatcgccgtgctgaccggcggcgtgaccctgttcttcctgagcggcagaggcctgggcaagaccagcatcggcctgctgtgcgtgaccagcagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacaccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatggccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatcgaggtggacagaagcgaggccagagagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggaggacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcatcgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16816 - RNA, 9879 nt, synthetic construct
  misc_feature 1..9879: note = derived and/or modified CDS sequence (opt4) from DENV-1__JQ915076__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccaccggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagaccatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggccacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgaccctgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggacgagctgggcgacggcctggccatgggcatcatgatcctgaagctgctgaccgacttccagagccaccagctgtgggccaccctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggcacttctggcagaagaagaagcagagaagcggcgtgctgtgggacacccccagcccccccgaggtggagaaggccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccatcatgctgctggccctgatcgccgtgctgaccggcggcgtgaccctgttcttcctgagcggcagaggcctgggcaagaccagcatcggcctgctgtgcgtgaccagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacaccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggaggacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcatcgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16817 - RNA, 9879 nt, synthetic construct
  misc_feature 1..9879: note = derived and/or modified CDS sequence (opt4) from DENV-1__KF289072__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgccgtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcagattctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16818 - RNA, 9879 nt, synthetic construct
  misc_feature 1..9879: note = derived and/or modified CDS sequence (opt4) from DENV-1__JQ692085__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgccgtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcagattctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccgtgggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccaacgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16819 - RNA, 9879 nt, synthetic construct
  misc_feature 1..9879: note = derived and/or modified CDS sequence (opt4) from DENV-1__JQ917404__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccagagagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcagattctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16820 - RNA, 9879 nt, synthetic construct
  misc_feature 1..9879: note = derived and/or modified CDS sequence (opt4) from DENV-1__GU370048__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctgaacttcaacgagatggtgctgctgaccatgaaggagaagagctggctggtgcacaagcagtggttcctggacctgcccctgccctggaccagcggcgccagcaccacccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccagaagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatcaccggcaccctggccgtgttcttcctgctgatcatgggccaggtgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagccccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctgtactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16821 - RNA, 9879 nt, synthetic construct
  misc_feature 1..9879: note = derived and/or modified CDS sequence (opt4) from DENV-1__KM403627__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggagagcttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16822 - RNA, 9879 nt, synthetic construct
  misc_feature 1..9879: note = derived and/or modified CDS sequence (opt4) from DENV-1__KM403584__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgaggtgcagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgcctacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcagattctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcatgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16823 - RNA, 9879 nt, synthetic construct
  misc_feature 1..9879: note = derived and/or modified CDS sequence (opt4) from DENV-1__KM403633__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgagagagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16824 - RNA, 9879 nt, synthetic construct
  misc_feature 1..9879: note = derived and/or modified CDS sequence (opt4) from DENV-1__KM403592__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtggcccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctggtgagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccatgcccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16825 - RNA, 9879 nt, synthetic construct
  misc_feature 1..9879: note = derived and/or modified CDS sequence (opt4) from DENV-1__KM403593__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtggcccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16826 - RNA, 9879 nt, synthetic construct
  misc_feature 1..9879: note = derived and/or modified CDS sequence (opt4) from DENV-1__KM403603__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagaccctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16827 - RNA, 9879 nt, synthetic construct
  misc_feature 1..9879: note = derived and/or modified CDS sequence (opt4) from DENV-1__KM403585__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcagaatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgaggtgcagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgcctacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcagattctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcgtggaggtggacagaagcgaggccaaggagggcatgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16828 - RNA, 9879 nt, synthetic construct
  misc_feature 1..9879: note = derived and/or modified CDS sequence (opt4) from DENV-1__KM403595__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacagaagaagcgtggccctggccccccacgtgggcctgggcctggagaccagaaccgagacctggatgagcagcgagggcgcctggagacagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagatcgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccatcttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagaccgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16829 - RNA, 9879 nt, synthetic construct
  misc_feature 1..9879: note = derived and/or modified CDS sequence (opt4) from DENV-1__KM403604__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcagggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16830 - RNA, 9879 nt, synthetic construct
  misc_feature 1..9879: note = derived and/or modified CDS sequence (opt4) from DENV-1__KM403588__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatgggcaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacatcgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcagagacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtggccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16831 - RNA, 9879 nt, synthetic construct
  misc_feature 1..9879: note = derived and/or modified CDS sequence (opt4) from DENV-1__KM403605__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcatccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagaccctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgaggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16832 - RNA, 9879 nt, synthetic construct
  misc_feature 1..9879: note = derived and/or modified CDS sequence (opt4) from DENV-1__KM403606__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccctggagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagaccctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16833 - RNA, 9879 nt, synthetic construct
  misc_feature 1..9879: note = derived and/or modified CDS sequence (opt4) from DENV-1__KM403591__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatgggcaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccaagagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16834 - RNA, 9879 nt, synthetic construct
  misc_feature 1..9879: note = derived and/or modified CDS sequence (opt4) from DENV-1__KM403607__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcatccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagaccctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16835 - RNA, 9879 nt, synthetic construct
  misc_feature 1..9879: note = derived and/or modified CDS sequence (opt4) from DENV-1__KM403581__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacagaagaagcgtggccctggccccccacgtgggcctgggcctggagaccagaaccgagacctggatgagcagcgagggcgcctggagacagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagctgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccatcttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16836 - RNA, 9879 nt, synthetic construct
  misc_feature 1..9879: note = derived and/or modified CDS sequence (opt4) from DENV-1__KM403597__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacagaagaagcgtggccctggccccccacgtgggcctgggcctggagaccagaaccgagacctggatgagcagcgagggcgcctggagacagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccatcttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatctgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16837 - RNA, 9879 nt, synthetic construct
  misc_feature 1..9879: note = derived and/or modified CDS sequence (opt4) from DENV-1__KM403610__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccatccacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcagcgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcaagaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16838 - RNA, 9879 nt, synthetic construct
  misc_feature 1..9879: note = derived and/or modified CDS sequence (opt4) from DENV-1__KM403596__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacagaagaagcgtggccctggccccccacgtgggcctgggcctggagaccagaaccgagacctggatgagcagcgagggcgcctggagacagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgagcctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagatcgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccatcttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagaccgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16839 - RNA, 9879 nt, synthetic construct
  misc_feature 1..9879: note = derived and/or modified CDS sequence (opt4) from DENV-1__KM403616__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtggtggtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgccttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16840 - RNA, 9879 nt, synthetic construct
  misc_feature 1..9879: note = derived and/or modified CDS sequence (opt4) from DENV-1__KM403617__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtggtggtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16841 - RNA, 9879 nt, synthetic construct
  misc_feature 1..9879: note = derived and/or modified CDS sequence (opt4) from DENV-1__KM403635__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcgccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactggtgggcaacgagaactacctggactacatgaccagcatgaagagattcaagaacgagagcgaccccgagggcgccctgtggtga

SEQ ID NO: 16842 - RNA, 9879 nt, synthetic construct
  misc_feature 1..9879: note = derived and/or modified CDS sequence (opt4) from DENV-1__KM403621__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggagagcttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16843 - RNA, 9879 nt, synthetic construct
  misc_feature 1..9879: note = derived and/or modified CDS sequence (opt4) from DENV-1__KM403623__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggagagcttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16844 - RNA, 9879 nt, synthetic construct
  misc_feature 1..9879: note = derived and/or modified CDS sequence (opt4) from DENV-1__KM403575__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16845 - RNA, 9879 nt, synthetic construct
  misc_feature 1..9879: note = derived and/or modified CDS sequence (opt4) from DENV-1__KM403586__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgaggtgcagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgcctacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcagattctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcatgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16846 - RNA, 9879 nt, synthetic construct
  misc_feature 1..9879: note = derived and/or modified CDS sequence (opt4) from DENV-1__KM403602__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccatcaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcagcgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcaagaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16847 - RNA, 9879 nt, synthetic construct
  misc_feature 1..9879: note = derived and/or modified CDS sequence (opt4) from DENV-1__KM403582__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacagaagaagcgtggccctggccccccacgtgggcctgggcctggagaccagaaccgagacctggatgagcagcgagggcgcctggagacagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcaccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatggtgatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccatcttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagaccgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16848 - RNA, 9879 nt, synthetic construct
  misc_feature 1..9879: note = derived and/or modified CDS sequence (opt4) from DENV-1__KM403577__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccatcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcctgctgtgcgtgagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgtgagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagagccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggtggccgagaaccaccaccacgccaccatgctggacatcgacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacatcgtgaagctgcacagcggcagagacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagacccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagaacagcaacctggccgagagagtgctggactggctggagaagcacggcgtggagagactgaagagaatggccatcagcggcgacgactgcgtggtgaagcccaccgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga
